United States Patent 11,931,406 (FLAVIVIRUS VACCINE) - sequence listing, part 26

SEQ ID NO: 11014 - RNA, 9879 nt, Artificial Sequence
  derived and/or modified CDS sequence (opt2) from DENV-1__FJ461307__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaucuccaugaagcgcuucaagaacgaguccgagcccgagggcgcccucugguga

SEQ ID NO: 11015 - RNA, 9879 nt, Artificial Sequence
  derived and/or modified CDS sequence (opt2) from DENV-1__FJ410213__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaaggacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11016 - RNA, 9879 nt, Artificial Sequence
  derived and/or modified CDS sequence (opt2) from DENV-1__FJ461308__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccugcaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11017 - RNA, 9879 nt, Artificial Sequence
  derived and/or modified CDS sequence (opt2) from DENV-1__FJ461310__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagcgcaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccaucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11018 - RNA, 9879 nt, Artificial Sequence
  derived and/or modified CDS sequence (opt2) from DENV-1__FJ906728__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucauccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccuccuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacaccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucgccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11019 - RNA, 9879 nt, Artificial Sequence
  derived and/or modified CDS sequence (opt2) from DENV-1__FJ461313__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcuccaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucaacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11020 - RNA, 9879 nt, Artificial Sequence
  derived and/or modified CDS sequence (opt2) from DENV-1__FJ547063__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccuccagcgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11021 - RNA, 9879 nt, Artificial Sequence
  derived and/or modified CDS sequence (opt2) from DENV-1__FJ410218__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgucgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11022 - RNA, 9879 nt, Artificial Sequence
  derived and/or modified CDS sequence (opt2) from DENV-1__FJ461316__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaugggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11023 - RNA, 9879 nt, Artificial Sequence
  derived and/or modified CDS sequence (opt2) from DENV-1__FJ410220__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucgucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11024 - RNA, 9879 nt, Artificial Sequence
  derived and/or modified CDS sequence (opt2) from DENV-1__JF937649__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11025 - RNA, 9879 nt, Artificial Sequence
  derived and/or modified CDS sequence (opt2) from DENV-1__FJ410222__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11026 - RNA, 9879 nt, Artificial Sequence
  derived and/or modified CDS sequence (opt2) from DENV-1__FJ461319__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccgccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacguccaggucgccaucaaccagguccgccgccucaucggcaacgagaacuaccucgacuacaugaccuccaugaagcgcuucaagaacgaguccgaccccgagggcgcccucugguga

SEQ ID NO: 11027 - RNA, 9879 nt, Artificial Sequence
  derived and/or modified CDS sequence (opt2) from DENV-1__FJ461320__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucauggucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11028 - RNA, 9879 nt, Artificial Sequence
  derived and/or modified CDS sequence (opt2) from DENV-1__FJ410225__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgagaucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccgcccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11029 - RNA, 9879 nt, Artificial Sequence
  derived and/or modified CDS sequence (opt2) from DENV-1__FJ410226__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggacaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugcauguccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11030 - RNA, 9879 nt, Artificial Sequence
  derived and/or modified CDS sequence (opt2) from DENV-1__FJ410227__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11031 - RNA, 9879 nt, Artificial Sequence
  derived and/or modified CDS sequence (opt2) from DENV-1__FJ859029__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagggcgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucguccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggccaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11032 - RNA, 9879 nt, Artificial Sequence
  derived and/or modified CDS sequence (opt2) from DENV-1__FJ547065__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccuccgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagacccgcaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgcaaguggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11033 - RNA, 9879 nt, Artificial Sequence
  derived and/or modified CDS sequence (opt2) from DENV-1__FJ410230__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaucggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauguccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucucccgcauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgccucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11034 - RNA, 9879 nt, Artificial Sequence
  derived and/or modified CDS sequence (opt2) from DENV-1__FJ410231__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11035 - RNA, 9879 nt, Artificial Sequence
  derived and/or modified CDS sequence (opt2) from DENV-1__FJ461323__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaccgaccccgagggcgcccucugguga

SEQ ID NO: 11036 - RNA, 9879 nt, Artificial Sequence
  derived and/or modified CDS sequence (opt2) from DENV-1__FJ461325__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11037 - RNA, 9879 nt, Artificial Sequence
  derived and/or modified CDS sequence (opt2) from DENV-1__FJ410232__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11038 - RNA, 9879 nt, Artificial Sequence
  derived and/or modified CDS sequence (opt2) from DENV-1__FJ461327__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaugggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11039 - RNA, 9879 nt, Artificial Sequence
  derived and/or modified CDS sequence (opt2) from DENV-1__FJ461328__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11040 - RNA, 9879 nt, Artificial Sequence
  derived and/or modified CDS sequence (opt2) from DENV-1__FJ410234__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccuccucccucgaggagcucggcgacggccucgccaugggcaucaugauccucaagcuccucaccgacuuccagucccaccagcucugggccacccuccucucccucaccuucaucaagaccgccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11041 - RNA, 9879 nt, Artificial Sequence
  derived and/or modified CDS sequence (opt2) from DENV-1__FJ410235__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccaccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucguccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccaucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucggcaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11042 - RNA, 9879 nt, Artificial Sequence
  derived and/or modified CDS sequence (opt2) from DENV-1__FJ410236__SS-prME
uccgucaccaugcuccucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggccaugaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucaagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11043 - RNA, 9879 nt, Artificial Sequence
  derived and/or modified CDS sequence (opt2) from DENV-1__FJ410238__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacaccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgucuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11044 - RNA, 9879 nt, Artificial Sequence
  derived and/or modified CDS sequence (opt2) from DENV-1__FJ410239__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccgucuuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11045 - RNA, 9879 nt, Artificial Sequence
  derived and/or modified CDS sequence (opt2) from DENV-1__FJ410240__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccgcccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11046 - RNA, 9879 nt, Artificial Sequence
  derived and/or modified CDS sequence (opt2) from DENV-1__FJ410242__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11047 - RNA, 9879 nt, Artificial Sequence
  derived and/or modified CDS sequence (opt2) from DENV-1__FJ410243__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggccccaugaagaucaaggacgaggagcgcgacgacaugcucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucauccuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11048 - RNA, 9879 nt, Artificial Sequence
  derived and/or modified CDS sequence (opt2) from DENV-1__FJ410244__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagaugaacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaaccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccaucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagguccccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11049 - RNA, 9879 nt, Artificial Sequence
  derived and/or modified CDS sequence (opt2) from DENV-1__FJ410245__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaucggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagaagaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11050 - RNA, 9879 nt, Artificial Sequence
  derived and/or modified CDS sequence (opt2) from DENV-1__FJ410246__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggacaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaccgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccacgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagcgccacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11051 - RNA, 9879 nt, Artificial Sequence
  derived and/or modified CDS sequence (opt2) from DENV-1__FJ410247__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaaccgcaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcagggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11052 - RNA, 9879 nt, Artificial Sequence
  derived and/or modified CDS sequence (opt2) from DENV-1__FJ410248__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgucgccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11053 - RNA, 9879 nt, Artificial Sequence
  derived and/or modified CDS sequence (opt2) from DENV-1__FJ410249__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcgccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcgucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuucuuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaccggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11054 - RNA, 9879 nt, Artificial Sequence
  derived and/or modified CDS sequence (opt2) from DENV-1__FJ410251__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcggcaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11055 - RNA, 9879 nt, Artificial Sequence
  derived and/or modified CDS sequence (opt2) from DENV-1__FJ410252__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgacuaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11056 - RNA, 9879 nt, Artificial Sequence
  derived and/or modified CDS sequence (opt2) from DENV-1__FJ461331__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgucgucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11057 - RNA, 9879 nt, Artificial Sequence
  derived and/or modified CDS sequence (opt2) from DENV-1__FJ410256__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucgucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11058 - RNA, 9879 nt, Artificial Sequence
  derived and/or modified CDS sequence (opt2) from DENV-1__FJ410257__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucaccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuucuccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaacuacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgaccgcaagaagcuccgcccccgcuggcucgacgcccgcaccuacuccgacccccucgcccuccgcgagcucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11059 - RNA, 9879 nt, Artificial Sequence
  derived and/or modified CDS sequence (opt2) from DENV-1__FJ461332__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgucgucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgucaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11060 - RNA, 9879 nt, Artificial Sequence
  derived and/or modified CDS sequence (opt2) from DENV-1__FJ461333__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacguccaggucgccaucaaccagguccgccgccucaucggcaacgagaacuaccucgacuacaugaccuccaugaagcgcuucaagaacgaguccgaccccgagggcgcccucugguga

SEQ ID NO: 11061 - RNA, 9879 nt, Artificial Sequence
  derived and/or modified CDS sequence (opt2) from DENV-1__FJ410262__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11062 - RNA, 9879 nt, Artificial Sequence
  derived and/or modified CDS sequence (opt2) from DENV-1__FJ410263__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaucaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11063 - RNA, 9879 nt, Artificial Sequence
  derived and/or modified CDS sequence (opt2) from DENV-1__FJ410264__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11064 - RNA, 9879 nt, Artificial Sequence
  derived and/or modified CDS sequence (opt2) from DENV-1__FJ410265__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11065 - RNA, 9879 nt, Artificial Sequence
  derived and/or modified CDS sequence (opt2) from DENV-1__FJ461336__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcguccucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11066 - RNA, 9879 nt, Artificial Sequence
  derived and/or modified CDS sequence (opt2) from DENV-1__FJ410266__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccaagaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaucgccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccggcgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11067 - RNA, 9879 nt, Artificial Sequence
  derived and/or modified CDS sequence (opt2) from DENV-1__FJ410269__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagauccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11068 - RNA, 9879 nt, Artificial Sequence
  derived and/or modified CDS sequence (opt2) from DENV-1__FJ410273__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgucgccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucacccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11069 - RNA, 9879 nt, Artificial Sequence
  derived and/or modified CDS sequence (opt2) from DENV-1__FJ410276__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11070 - RNA, 9879 nt, Artificial Sequence
  derived and/or modified CDS sequence (opt2) from DENV-1__FJ410278__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagcgcaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11071 - RNA, 9879 nt, Artificial Sequence
  derived and/or modified CDS sequence (opt2) from DENV-1__FJ410279__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuuccucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcgucuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11072 - RNA, 9879 nt, Artificial Sequence
  derived and/or modified CDS sequence (opt2) from DENV-1__FJ410283__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11073 - RNA, 9879 nt, Artificial Sequence
  derived and/or modified CDS sequence (opt2) from DENV-1__FJ410284__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagaaggacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaccaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11074 - RNA, 9879 nt, Artificial Sequence
  derived and/or modified CDS sequence (opt2) from DENV-1__FJ410285__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccagcacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucucccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggccccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucgccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11075 - RNA, 9879 nt, Artificial Sequence
  derived and/or modified CDS sequence (opt2) from DENV-1__FJ410286__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11076 - RNA, 9879 nt, Artificial Sequence
  derived and/or modified CDS sequence (opt2) from DENV-1__FJ461339__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgucggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagaccuccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11077 - RNA, 9879 nt, Artificial Sequence
  derived and/or modified CDS sequence (opt2) from DENV-1__FJ882515__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggccccaggucccccacugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgaggacgaccccgagggcgcccucugguga

SEQ ID NO: 11078 - RNA, 9879 nt, Artificial Sequence
  derived and/or modified CDS sequence (opt2) from DENV-1__FJ882517__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgaggaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggucaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11079 - RNA, 9879 nt, Artificial Sequence
  derived and/or modified CDS sequence (opt2) from DENV-1__JQ287661__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11080 - RNA, 9879 nt, Artificial Sequence
  derived and/or modified CDS sequence (opt2) from DENV-1__FJ882518__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccuccacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11081 - RNA, 9879 nt, Artificial Sequence
  derived and/or modified CDS sequence (opt2) from DENV-1__FJ882519__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11082 - RNA, 9879 nt, Artificial Sequence
  derived and/or modified CDS sequence (opt2) from DENV-1__FJ882520__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11083 - RNA, 9879 nt, Artificial Sequence
  derived and/or modified CDS sequence (opt2) from DENV-1__FJ882523__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacgaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11084 - RNA, 9879 nt, Artificial Sequence
  derived and/or modified CDS sequence (opt2) from DENV-1__FJ882524__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuacgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaccgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11085 - RNA, 9879 nt, Artificial Sequence
  derived and/or modified CDS sequence (opt2) from DENV-1__FJ882525__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucgucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagauccgcuacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaacuucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11086 - RNA, 9879 nt, Artificial Sequence
  derived and/or modified CDS sequence (opt2) from DENV-1__FJ882526__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagcgcgcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11087 - RNA, 9879 nt, Artificial Sequence
  derived and/or modified CDS sequence (opt2) from DENV-1__FJ882527__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucgccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11088 - RNA, 9879 nt, Artificial Sequence
  derived and/or modified CDS sequence (opt2) from DENV-1__FJ882529__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacgucaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11089 - RNA, 9879 nt, Artificial Sequence
  derived and/or modified CDS sequence (opt2) from DENV-1__FJ882530__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11090 - RNA, 9879 nt, Artificial Sequence
  derived and/or modified CDS sequence (opt2) from DENV-1__GQ868605__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgacaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucuccaucuccaucaugaucgaggaggucaugcgcucccgcuggucccgcaagaugcucaugaccggcacccucgccgucuuccuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccgcccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgagaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggcuccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucaucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11091 - RNA, 9879 nt, Artificial Sequence
  derived and/or modified CDS sequence (opt2) from DENV-1__FJ882534__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcccccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgucgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11092 - RNA, 9879 nt, Artificial Sequence
  derived and/or modified CDS sequence (opt2) from DENV-1__FJ882536__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11093 - RNA, 9879 nt, Artificial Sequence
  derived and/or modified CDS sequence (opt2) from DENV-1__FJ882537__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccaccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugguccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcacaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11094 - RNA, 9879 nt, Artificial Sequence
  derived and/or modified CDS sequence (opt2) from DENV-1__GQ868606__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11095 - RNA, 9879 nt, Artificial Sequence
  derived and/or modified CDS sequence (opt2) from DENV-1__FJ882539__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgcccucgccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcaucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11096 - RNA, 9879 nt, Artificial Sequence
  derived and/or modified CDS sequence (opt2) from DENV-1__FJ882541__SS-prME
uccgucaccaugcuccucaugcucauccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11097 - RNA, 9879 nt, Artificial Sequence
  derived and/or modified CDS sequence (opt2) from DENV-1__FJ882542__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccuccacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcaugacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11098 - RNA, 9879 nt, Artificial Sequence
  derived and/or modified CDS sequence (opt2) from DENV-1__FJ882543__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccgcccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccucggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11099 - RNA, 9879 nt, Artificial Sequence
  derived and/or modified CDS sequence (opt2) from DENV-1__FJ882544__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaagggcaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11100 - RNA, 9879 nt, Artificial Sequence
  derived and/or modified CDS sequence (opt2) from DENV-1__FJ898371__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11101 - RNA, 9879 nt, Artificial Sequence
  derived and/or modified CDS sequence (opt2) from DENV-1__FJ882545__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11102 - RNA, 9879 nt, Artificial Sequence
  derived and/or modified CDS sequence (opt2) from DENV-1__FJ898372__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggcccgcgacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11103 - RNA, 9879 nt, Artificial Sequence
  derived and/or modified CDS sequence (opt2) from DENV-1__FJ898373__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccaccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccgucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugguccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcacaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11104 - RNA, 9879 nt, Artificial Sequence
  derived and/or modified CDS sequence (opt2) from DENV-1__FJ898374__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11105 - RNA, 9879 nt, Artificial Sequence
  derived and/or modified CDS sequence (opt2) from DENV-1__FJ898375__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaagcaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11106 - RNA, 9879 nt, Artificial Sequence
  derived and/or modified CDS sequence (opt2) from DENV-1__FJ898376__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaacugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11107 - RNA, 9879 nt, Artificial Sequence
  derived and/or modified CDS sequence (opt2) from DENV-1__FJ898379__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11108 - RNA, 9879 nt, Artificial Sequence
  derived and/or modified CDS sequence (opt2) from DENV-1__GQ199773__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaccgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucuggaaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11109 - RNA, 9879 nt, Artificial Sequence
  derived and/or modified CDS sequence (opt2) from DENV-1__JF937596__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11110 - RNA, 9879 nt, Artificial Sequence
  derived and/or modified CDS sequence (opt2) from DENV-1__FJ898380__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11111 - RNA, 9879 nt, Artificial Sequence
  derived and/or modified CDS sequence (opt2) from DENV-1__FJ898382__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuucuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11112 - RNA, 9879 nt, Artificial Sequence
  derived and/or modified CDS sequence (opt2) from DENV-1__FJ898383__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccaucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11113 - RNA, 9879 nt, Artificial Sequence
  derived and/or modified CDS sequence (opt2) from DENV-1__FJ898384__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccaucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11114 - RNA, 9879 nt, Artificial Sequence
  derived and/or modified CDS sequence (opt2) from DENV-1__FJ898385__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcggcgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaugggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11115 - RNA, 9879 nt, Artificial Sequence
  derived and/or modified CDS sequence (opt2) from DENV-1__GQ868608__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccuggaaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacaugcucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11116 - RNA, 9879 nt, Artificial Sequence
  derived and/or modified CDS sequence (opt2) from DENV-1__GQ199774__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccaccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugguccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccguccgcgagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcacaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11117 - RNA, 9879 nt, Artificial Sequence
  derived and/or modified CDS sequence (opt2) from DENV-1__GQ199775__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccaccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugguccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccguccgcgagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcacaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucuggacccgcgaggaggucacccgcaagguccgcuccaacgccggcaucggcgccggcgucggcgacgagaaccaguggaacuccgccaagaagggcgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11118 - RNA, 9876 nt, Artificial Sequence
  derived and/or modified CDS sequence (opt2) from DENV-1__FJ882546__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgcaaguccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgagcuccaccucggccagcagcgcgucuucaaggagaaggucgacacccgcaccccccgcgccaagcgcggcaccgcccagaucauggagaugaccgcccgcuggcucuggggcuuccucucccgcaacaagaucccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11119 - RNA, 9879 nt, Artificial Sequence
  derived and/or modified CDS sequence (opt2) from DENV-1__KF921935__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaaggagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11120 - RNA, 9879 nt, Artificial Sequence
  derived and/or modified CDS sequence (opt2) from DENV-1__GQ199776__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgucgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11121 - RNA, 9879 nt, Artificial Sequence
  derived and/or modified CDS sequence (opt2) from DENV-1__GQ199777__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucgccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11122 - RNA, 9879 nt, Artificial Sequence
  derived and/or modified CDS sequence (opt2) from DENV-1__GQ199778__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggaggccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccaucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11123 - RNA, 9879 nt, Artificial Sequence
  derived and/or modified CDS sequence (opt2) from DENV-1__GQ199780__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11124 - RNA, 9879 nt, Artificial Sequence
  derived and/or modified CDS sequence (opt2) from DENV-1__GQ199781__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucauccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggcccgccgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11125 - RNA, 9879 nt, Artificial Sequence
  derived and/or modified CDS sequence (opt2) from DENV-1__GQ199782__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacauccagaacaccaccuucaucaucgacggccccaacacccccgagugccccgacgaccagcgcgccuggaacaucugggaggucgaggacuacggcuucggcaucuucaccaccaacaucuggcuccgccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucauggucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucguccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaugaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11126 - RNA, 9879 nt, Artificial Sequence
  derived and/or modified CDS sequence (opt2) from DENV-1__GQ199783__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggcaccuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccuccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccaccacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11127 - RNA, 9879 nt, Artificial Sequence
  derived and/or modified CDS sequence (opt2) from DENV-1__GQ199784__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11128 - RNA, 9879 nt, Artificial Sequence
  derived and/or modified CDS sequence (opt2) from DENV-1__GQ199785__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucaugaagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11129 - RNA, 9879 nt, Artificial Sequence
  derived and/or modified CDS sequence (opt2) from DENV-1__GQ199786__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucauccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11130 - RNA, 9879 nt, Artificial Sequence
  derived and/or modified CDS sequence (opt2) from DENV-1__GQ199787__SS-prME
uccgucaccaugcuccucaugcucguccccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuuccucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaacgaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11131 - RNA, 9879 nt, Artificial Sequence
  derived and/or modified CDS sequence (opt2) from DENV-1__GQ199788__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11132 - RNA, 9879 nt, Artificial Sequence
  derived and/or modified CDS sequence (opt2) from DENV-1__GQ199789__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagggcgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucguccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaucgaggcccagcucauccgccagauggaguccgaggagaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11133 - RNA, 9879 nt, Artificial Sequence
  derived and/or modified CDS sequence (opt2) from DENV-1__GQ199790__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11134 - RNA, 9879 nt, Artificial Sequence
  derived and/or modified CDS sequence (opt2) from DENV-1__GQ199791__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggcguccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgccuucugguga

SEQ ID NO: 11135 - RNA, 9879 nt, Artificial Sequence
  derived and/or modified CDS sequence (opt2) from DENV-1__GQ199792__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacgccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaugggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccggcgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11136 - RNA, 9879 nt, Artificial Sequence
  derived and/or modified CDS sequence (opt2) from DENV-1__GQ199793__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccaccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacgccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11137 - RNA, 9879 nt, Artificial Sequence
  derived and/or modified CDS sequence (opt2) from DENV-1__GQ199795__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggaccccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11138 - RNA, 9873 nt, Artificial Sequence
  derived and/or modified CDS sequence (opt2) from DENV-1__FJ882547__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaucggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagggcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccaugucccccaucgccaugaccgacaccaccccccucgcccagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11139 - RNA, 9879 nt, Artificial Sequence
  derived and/or modified CDS sequence (opt2) from DENV-1__GQ199797__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagaccaugaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11140 - RNA, 9879 nt, Artificial Sequence
  derived and/or modified CDS sequence (opt2) from DENV-1__GQ199799__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11141 - RNA, 9879 nt, Artificial Sequence
  derived and/or modified CDS sequence (opt2) from DENV-1__GQ199800__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11142 - RNA, 9879 nt, Artificial Sequence
  derived and/or modified CDS sequence (opt2) from DENV-1__FJ882548__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11143 - RNA, 9879 nt, Artificial Sequence
  derived and/or modified CDS sequence (opt2) from DENV-1__GQ199801__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucacccgccucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccaagaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcauccccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11144 - RNA, 9879 nt, Artificial Sequence
  derived and/or modified CDS sequence (opt2) from DENV-1__GQ199802__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucugggucuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11145 - RNA, 9879 nt, Artificial Sequence
  derived and/or modified CDS sequence (opt2) from DENV-1__JF937597__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucaacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11146 - RNA, 9879 nt, Artificial Sequence
  derived and/or modified CDS sequence (opt2) from DENV-1__GQ868609__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcuccgccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11147 - RNA, 9879 nt, Artificial Sequence
  derived and/or modified CDS sequence (opt2) from DENV-1__GQ199803__SS-prME
uccgucaccaugcuccucaugcucaugcccaccgcccucgccuuccaccucaccauccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccuccucccucgaggagcucggcgacggccucgccaugggcaucaugauccucaagcuccucaccgacuuccagucccaccagcucugggccacccuccucucccucaccuucaucaagaccgccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgaccgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11148 - RNA, 9879 nt, Artificial Sequence
  derived and/or modified CDS sequence (opt2) from DENV-1__GQ199804__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgacgccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11149 - RNA, 9879 nt, Artificial Sequence
  derived and/or modified CDS sequence (opt2) from DENV-1__GQ199805__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucgccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccagaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11150 - RNA, 9879 nt, Artificial Sequence
  derived and/or modified CDS sequence (opt2) from DENV-1__GQ199806__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggccgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgucgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggacggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucaacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaaguacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11151 - RNA, 9879 nt, Artificial Sequence
  derived and/or modified CDS sequence (opt2) from DENV-1__GQ199809__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaacugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11152 - RNA, 9879 nt, Artificial Sequence
  derived and/or modified CDS sequence (opt2) from DENV-1__GQ199810__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggucgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11153 - RNA, 9879 nt, Artificial Sequence
  derived and/or modified CDS sequence (opt2) from DENV-1__GQ199811__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucguccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11154 - RNA, 9879 nt, Artificial Sequence
  derived and/or modified CDS sequence (opt2) from DENV-1__FJ882549__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcguccucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11155 - RNA, 9879 nt, Artificial Sequence
  derived and/or modified CDS sequence (opt2) from DENV-1__GQ199814__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggacaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaccgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11156 - RNA, 9879 nt, Artificial Sequence
  derived and/or modified CDS sequence (opt2) from DENV-1__GQ199816__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcauccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11157 - RNA, 9879 nt, Artificial Sequence
  derived and/or modified CDS sequence (opt2) from DENV-1__GQ199817__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggugcuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuuccuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11158 - RNA, 9879 nt, Artificial Sequence
  derived and/or modified CDS sequence (opt2) from DENV-1__FJ882550__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaugaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11159 - RNA, 9879 nt, Artificial Sequence
  derived and/or modified CDS sequence (opt2) from DENV-1__FJ882551__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcaggagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucaagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagcucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11160 - RNA, 9879 nt, Artificial Sequence
  derived and/or modified CDS sequence (opt2) from DENV-1__FJ882552__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuccucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11161 - RNA, 9879 nt, Artificial Sequence
  derived and/or modified CDS sequence (opt2) from DENV-1__FJ882553__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguuccgcaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgagcccgagggcgcccucugguga

SEQ ID NO: 11162 - RNA, 9879 nt, Artificial Sequence
  derived and/or modified CDS sequence (opt2) from DENV-1__FJ882554__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuacuccaucgccgcccgcggcuacaucuccacccgcgucggcaugggcgaggccgccgccaucuucaugaccgccaccccccccggcuccgucgaggccuucccccaguccaacgccgucaucaaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11163 - RNA, 9879 nt, Artificial Sequence
  derived and/or modified CDS sequence (opt2) from DENV-1__GQ868610__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaucgccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11164 - RNA, 9879 nt, Artificial Sequence
  derived and/or modified CDS sequence (opt2) from DENV-1__GQ868611__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11165 - RNA, 9879 nt, Artificial Sequence
  derived and/or modified CDS sequence (opt2) from DENV-1__FJ882555__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccgccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccagaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaaggucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11166 - RNA, 9879 nt, Artificial Sequence
  derived and/or modified CDS sequence (opt2) from DENV-1__GQ199821__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgucgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggaucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11167 - RNA, 9879 nt, Artificial Sequence
  derived and/or modified CDS sequence (opt2) from DENV-1__FJ882556__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucuccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11168 - RNA, 9879 nt, Artificial Sequence
  derived and/or modified CDS sequence (opt2) from DENV-1__GQ199822__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggccgcgccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgcccucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11169 - RNA, 9879 nt, Artificial Sequence
  derived and/or modified CDS sequence (opt2) from DENV-1__FJ882557__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucaccaugaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11170 - RNA, 9879 nt, Artificial Sequence
  derived and/or modified CDS sequence (opt2) from DENV-1__FJ882558__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucaccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagaccaugaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11171 - RNA, 9879 nt, Artificial Sequence
  derived and/or modified CDS sequence (opt2) from DENV-1__GQ199824__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagauccucaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11172 - RNA, 9879 nt, Artificial Sequence
  derived and/or modified CDS sequence (opt2) from DENV-1__FJ882559__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggcccgcaucaucggcgccgacguccagaacaccaccuucaucaucgacggccccaacacccccgagugccccgacgaccagcgcgccuggaacaucugggaggucgaggacuacggcuucggcaucuucaccaccaacaucuggcuccgccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucguccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucguccgccuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11173 - RNA, 9879 nt, Artificial Sequence
  derived and/or modified CDS sequence (opt2) from DENV-1__GQ199828__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccgcgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaagaacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgacaaggccaucggcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11174 - RNA, 9879 nt, Artificial Sequence
  derived and/or modified CDS sequence (opt2) from DENV-1__GQ199829__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11175 - RNA, 9879 nt, Artificial Sequence
  derived and/or modified CDS sequence (opt2) from DENV-1__FJ882562__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaugaccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11176 - RNA, 9879 nt, Artificial Sequence
  derived and/or modified CDS sequence (opt2) from DENV-1__FJ882564__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauggucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11177 - RNA, 9879 nt, Artificial Sequence
  derived and/or modified CDS sequence (opt2) from DENV-1__FJ882565__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcggcuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11178 - RNA, 9879 nt, Artificial Sequence
  derived and/or modified CDS sequence (opt2) from DENV-1__FJ882567__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11179 - RNA, 9879 nt, Artificial Sequence
  derived and/or modified CDS sequence (opt2) from DENV-1__GQ199831__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccgaccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11180 - RNA, 9879 nt, Artificial Sequence
  derived and/or modified CDS sequence (opt2) from DENV-1__GQ199832__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuacaagcacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11181 - RNA, 9879 nt, Artificial Sequence
  derived and/or modified CDS sequence (opt2) from DENV-1__FJ882568__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccgucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11182 - RNA, 9879 nt, Artificial Sequence
  derived and/or modified CDS sequence (opt2) from DENV-1__FJ882569__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11183 - RNA, 9879 nt, Artificial Sequence
  derived and/or modified CDS sequence (opt2) from DENV-1__GQ199833__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11184 - RNA, 9879 nt, Artificial Sequence
  derived and/or modified CDS sequence (opt2) from DENV-1__FJ882570__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacaucuucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccgcccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11185 - RNA, 9879 nt, Artificial Sequence
  derived and/or modified CDS sequence (opt2) from DENV-1__GQ199834__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgacggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11186 - RNA, 9879 nt, Artificial Sequence
  derived and/or modified CDS sequence (opt2) from DENV-1__GQ199835__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucacccucauggccaccuucaagaugcgccccauguucgccgucggccuccuccuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11187 - RNA, 9879 nt, Artificial Sequence
  derived and/or modified CDS sequence (opt2) from DENV-1__FJ898386__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgccuucugguga

SEQ ID NO: 11188 - RNA, 9879 nt, Artificial Sequence
  derived and/or modified CDS sequence (opt2) from DENV-1__FJ898387__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11189 - RNA, 9879 nt, Artificial Sequence
  derived and/or modified CDS sequence (opt2) from DENV-1__FJ898389__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccucuuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcuccuucggcugcaagccccucgccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuucuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11190 - RNA, 9879 nt, Artificial Sequence
  derived and/or modified CDS sequence (opt2) from DENV-1__FJ898390__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11191 - RNA, 9879 nt, Artificial Sequence
  derived and/or modified CDS sequence (opt2) from DENV-1__FJ898391__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11192 - RNA, 9879 nt, Artificial Sequence
  derived and/or modified CDS sequence (opt2) from DENV-1__FJ898392__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11193 - RNA, 9879 nt, Artificial Sequence
  derived and/or modified CDS sequence (opt2) from DENV-1__FJ898393__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11194 - RNA, 9879 nt, Artificial Sequence
  derived and/or modified CDS sequence (opt2) from DENV-1__FJ898394__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccccccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11195 - RNA, 9879 nt, Artificial Sequence
  derived and/or modified CDS sequence (opt2) from DENV-1__GQ199838__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11196 - RNA, 9879 nt, Artificial Sequence
  derived and/or modified CDS sequence (opt2) from DENV-1__FJ898396__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucacccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11197 - RNA, 9879 nt, Artificial Sequence
  derived and/or modified CDS sequence (opt2) from DENV-1__GQ199839__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccgcaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggccucaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacaucuucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccgcccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11198 - RNA, 9879 nt, Artificial Sequence
  derived and/or modified CDS sequence (opt2) from DENV-1__FJ898397__SS-prME
uccgucaccaugcuccucaugcucaugcccaccgcccucgccuuccaccucaccauccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11199 - RNA, 9879 nt, Artificial Sequence
  derived and/or modified CDS sequence (opt2) from DENV-1__FJ898398__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggaguccauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucaacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11200 - RNA, 9879 nt, Artificial Sequence
  derived and/or modified CDS sequence (opt2) from DENV-1__FJ898399__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11201 - RNA, 9879 nt, Artificial Sequence
  derived and/or modified CDS sequence (opt2) from DENV-1__FJ898401__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacggccacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagaaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccacggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11202 - RNA, 9879 nt, Artificial Sequence
  derived and/or modified CDS sequence (opt2) from DENV-1__FJ898402__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggaccgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11203 - RNA, 9879 nt, Artificial Sequence
  derived and/or modified CDS sequence (opt2) from DENV-1__FJ898403__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11204 - RNA, 9879 nt, Artificial Sequence
  derived and/or modified CDS sequence (opt2) from DENV-1__FJ898404__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11205 - RNA, 9879 nt, Artificial Sequence
  derived and/or modified CDS sequence (opt2) from DENV-1__GQ199840__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaccggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacauccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11206 - RNA, 9879 nt, Artificial Sequence
  derived and/or modified CDS sequence (opt2) from DENV-1__FJ898405__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccaacaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11207 - RNA, 9879 nt, Artificial Sequence
  derived and/or modified CDS sequence (opt2) from DENV-1__FJ898406__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccaacaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacauggccuccaugaagcgcuucaagaacgagggcgaccccgagggcgcccucugguga

SEQ ID NO: 11208 - RNA, 9879 nt, Artificial Sequence
  derived and/or modified CDS sequence (opt2) from DENV-1__GQ199841__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11209 - RNA, 9879 nt, Artificial Sequence
  derived and/or modified CDS sequence (opt2) from DENV-1__FJ898407__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11210 - RNA, 9879 nt, Artificial Sequence
  derived and/or modified CDS sequence (opt2) from DENV-1__FJ898408__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccgaccccggcgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11211 - RNA, 9879 nt, Artificial Sequence
  derived and/or modified CDS sequence (opt2) from DENV-1__GQ199843__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11212 - RNA, 9879 nt, Artificial Sequence
  derived and/or modified CDS sequence (opt2) from DENV-1__GQ199844__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11213 - RNA, 9879 nt, Artificial Sequence
  derived and/or modified CDS sequence (opt2) from DENV-1__GQ199845__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcauguucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaccaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11214 - RNA, 9879 nt, Artificial Sequence
  derived and/or modified CDS sequence (opt2) from DENV-1__GQ199846__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaucauggcccgcgacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11215 - RNA, 9879 nt, Artificial Sequence
  derived and/or modified CDS sequence (opt2) from DENV-1__GQ199847__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccgaccccgacgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11216 - RNA, 9879 nt, Artificial Sequence
  derived and/or modified CDS sequence (opt2) from DENV-1__GQ199849__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccgcaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucgcccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggccucaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagcgcaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacaucuucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccgcccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11217 - RNA, 9879 nt, Artificial Sequence
  derived and/or modified CDS sequence (opt2) from DENV-1__FJ898410__SS-prME
uccgucaccaugcuccucaugcucacccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11218 - RNA, 9879 nt, Artificial Sequence
  derived and/or modified CDS sequence (opt2) from DENV-1__FJ898411__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11219 - RNA, 9879 nt, Artificial Sequence
  derived and/or modified CDS sequence (opt2) from DENV-1__FJ898412__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgucaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11220 - RNA, 9879 nt, Artificial Sequence
  derived and/or modified CDS sequence (opt2) from DENV-1__GQ199852__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaccaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucccccuccacugcgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11221 - RNA, 9879 nt, Artificial Sequence
  derived and/or modified CDS sequence (opt2) from DENV-1__FJ898415__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccaacaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaccauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11222 - RNA, 9879 nt, Artificial Sequence
  derived and/or modified CDS sequence (opt2) from DENV-1__FJ898416__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcguccucugguga

SEQ ID NO: 11223 - RNA, 9879 nt, Artificial Sequence
  derived and/or modified CDS sequence (opt2) from DENV-1__FJ898417__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccgaccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11224 - RNA, 9879 nt, Artificial Sequence
  derived and/or modified CDS sequence (opt2) from DENV-1__GQ868612__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccucccucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11225 - RNA, 9879 nt, Artificial Sequence
  derived and/or modified CDS sequence (opt2) from DENV-1__FJ898419__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcuggacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11226 - RNA, 9879 nt, Artificial Sequence
  derived and/or modified CDS sequence (opt2) from DENV-1__FJ898420__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggccgccucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccacaagcgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11227 - RNA, 9879 nt, Artificial Sequence
  derived and/or modified CDS sequence (opt2) from DENV-1__FJ898421__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucuccaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccggccccgagggcgcccucugguga

SEQ ID NO: 11228 - RNA, 9879 nt, Artificial Sequence
  derived and/or modified CDS sequence (opt2) from DENV-1__FJ898423__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucauccaguacgagaaccucaaguacuccgucaucgucaccguccacaccggcgaccagcaccaggucggcaacgaguccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccaccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugguccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcacaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11229 - RNA, 9879 nt, Artificial Sequence
  derived and/or modified CDS sequence (opt2) from DENV-1__FJ898424__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccaccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11230 - RNA, 9879 nt, Artificial Sequence
  derived and/or modified CDS sequence (opt2) from DENV-1__FJ898425__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11231 - RNA, 9879 nt, Artificial Sequence
  derived and/or modified CDS sequence (opt2) from DENV-1__FJ898426__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucgccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11232 - RNA, 9879 nt, Artificial Sequence
  derived and/or modified CDS sequence (opt2) from DENV-1__GQ199856__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucgucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaacuucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaagcucaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11233 - RNA, 9879 nt, Artificial Sequence
  derived and/or modified CDS sequence (opt2) from DENV-1__FJ898427__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacugcgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11234 - RNA, 9879 nt, Artificial Sequence
  derived and/or modified CDS sequence (opt2) from DENV-1__JF937599__SS-prME
uccgucaccaugcuccucaugcucaugcccaccgcccucgccuuccaccucaccgcccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagguccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11235 - RNA, 9879 nt, Artificial Sequence
  derived and/or modified CDS sequence (opt2) from DENV-1__FJ898431__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccguccucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11236 - RNA, 9879 nt, Artificial Sequence
  derived and/or modified CDS sequence (opt2) from DENV-1__GU131678__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcaugaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucaaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuuccuccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgccggcgagcgcaacaaccagguccucgaggagaacauggacgucgagaucuggaccaaggagggcgagcgcaagaagcuccucccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggaugggcuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgccaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggccccgccaagcuccgcugguucgucgagcgcacccucgucaaccccgagggcaaggucaucgcccucggcugcggccgcggcgccugguccuacuacugcgccggccucaagaagggcaccgaggucaagggcuacaccaagggcggccccggccacgaggagcccauccccauggccaccuacggcugggaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgaccccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugccccaccugcgucuacaacaugaugggcaagcgcgagaagaagcucggcgaguucggcaaggccaagggcucccgccccaucugguacauguggcucggcgcccgcuuccucgaguucgaggcccucggcuucaugaacgaggaccacugguucucccgcgagaacucccucuccggcgucgagggcgaggcccuccacaagcucggcuacauccuccgcgacaucuccaagauccccggcggcaacauguacgccgacgacaccgccggcugggacacccgcaucaccgaggacgaccuccagaacgagggcaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggacccuccgcgagaccgccugccucggcaaguccuacgcccagauguggcagcucauguacuucccccgccgcgcccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccccccgcgccaccuggcccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11237 - RNA, 9879 nt, Artificial Sequence
  derived and/or modified CDS sequence (opt2) from DENV-1__GU131679__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacaugcucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgagcucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11238 - RNA, 9879 nt, Artificial Sequence
  derived and/or modified CDS sequence (opt2) from DENV-1__GU131680__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11239 - RNA, 9879 nt, Artificial Sequence
  derived and/or modified CDS sequence (opt2) from DENV-1__GU131681__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagguccucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcgcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11240 - RNA, 9879 nt, Artificial Sequence
  derived and/or modified CDS sequence (opt2) from DENV-1__GU131682__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11241 - RNA, 9879 nt, Artificial Sequence
  derived and/or modified CDS sequence (opt2) from DENV-1__GU131683__SS-prME
uccgucaccaugcuccucaugcucaugcccaccgcccucgccuuccaccucaccacccgcggcggcgagccccacaugaucgucuccaagcaggagcgcggcaagucccuccucuucaagacccccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucgcccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuucuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11242 - RNA, 9879 nt, Artificial Sequence
  derived and/or modified CDS sequence (opt2) from DENV-1__GU131684__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccaaggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11243 - RNA, 9879 nt, Artificial Sequence
  derived and/or modified CDS sequence (opt2) from DENV-1__GU131685__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggagaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11244 - RNA, 9879 nt, Artificial Sequence
  derived and/or modified CDS sequence (opt2) from DENV-1__GQ868614__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11245 - RNA, 9879 nt, Artificial Sequence
  derived and/or modified CDS sequence (opt2) from DENV-1__GU131688__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11246 - RNA, 9879 nt, Artificial Sequence
  derived and/or modified CDS sequence (opt2) from DENV-1__GU131689__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaugaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11247 - RNA, 9879 nt, Artificial Sequence
  derived and/or modified CDS sequence (opt2) from DENV-1__GU131690__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11248 - RNA, 9879 nt, Artificial Sequence
  derived and/or modified CDS sequence (opt2) from DENV-1__GU131695__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcaccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11249 - RNA, 9879 nt, Artificial Sequence
  derived and/or modified CDS sequence (opt2) from DENV-1__GU131697__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccaguaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaacaagcaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11250 - RNA, 9879 nt, Artificial Sequence
  derived and/or modified CDS sequence (opt2) from DENV-1__GU131700__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucaccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagaccaugaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11251 - RNA, 9879 nt, Artificial Sequence
  derived and/or modified CDS sequence (opt2) from DENV-1__GU131701__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaccgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgccuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccaccgccucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccggcaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11252 - RNA, 9879 nt, Artificial Sequence
  derived and/or modified CDS sequence (opt2) from DENV-1__GU131703__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11253 - RNA, 9879 nt, Artificial Sequence
  derived and/or modified CDS sequence (opt2) from DENV-1__GU131706__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguuccgcaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11254 - RNA, 9879 nt, Artificial Sequence
  derived and/or modified CDS sequence (opt2) from DENV-1__GU131708__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccuccuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaugggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11255 - RNA, 9879 nt, Artificial Sequence
  derived and/or modified CDS sequence (opt2) from DENV-1__GU131710__SS-prME
uccgucaccaugcuccucaugcucaugcccaccgcccucgccuuccaccucaccacccgcggcggcgagccccacaugaucgccuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagcgcaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11256 - RNA, 9879 nt, Artificial Sequence
  derived and/or modified CDS sequence (opt2) from DENV-1__GU131717__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucaugcaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11257 - RNA, 9879 nt, Artificial Sequence
  derived and/or modified CDS sequence (opt2) from DENV-1__GU131718__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaucgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaucgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11258 - RNA, 9879 nt, Artificial Sequence
  derived and/or modified CDS sequence (opt2) from DENV-1__GU131720__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucgccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucaugaagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11259 - RNA, 9879 nt, Artificial Sequence
  derived and/or modified CDS sequence (opt2) from DENV-1__HM181960__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggccgcgucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11260 - RNA, 9879 nt, Artificial Sequence
  derived and/or modified CDS sequence (opt2) from DENV-1__HM181963__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaucggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaaggucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11261 - RNA, 9879 nt, Artificial Sequence
  derived and/or modified CDS sequence (opt2) from DENV-1__HM181964__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccucuccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11262 - RNA, 9879 nt, Artificial Sequence
  derived and/or modified CDS sequence (opt2) from DENV-1__HM181966__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccucgacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaucgccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucgucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11263 - RNA, 9879 nt, Artificial Sequence
  derived and/or modified CDS sequence (opt2) from DENV-1__GU131721__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucguccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgagcccgagggcgcccucugguga

SEQ ID NO: 11264 - RNA, 9879 nt, Artificial Sequence
  derived and/or modified CDS sequence (opt2) from DENV-1__GU131723__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11265 - RNA, 9879 nt, Artificial Sequence
  derived and/or modified CDS sequence (opt2) from DENV-1__GU131725__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucuccgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagggcgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccucccgcggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11266 - RNA, 9879 nt, Artificial Sequence
  derived and/or modified CDS sequence (opt2) from DENV-1__GU131726__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucgccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccuccuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccucccccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11267 - RNA, 9879 nt, Artificial Sequence
  derived and/or modified CDS sequence (opt2) from DENV-1__GU131727__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguaccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11268 - RNA, 9879 nt, Artificial Sequence
  derived and/or modified CDS sequence (opt2) from DENV-1__HM631850__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccucccccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11269 - RNA, 9879 nt, Artificial Sequence
  derived and/or modified CDS sequence (opt2) from DENV-1__KF955446__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggccgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucggcgccuccgagauggccgaggcccucaagggcaugcccauccgcuaccagaccaccgccgucaaguccgagcacaccggcaaggagaucgucgaccucaugggccacgccaccuucaccaugggccuccucgcccccggccgcguccccaacuacaacauggucaucauggacgaggcccacuucaccgaccccucccgcaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaaccccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccccuggaccgaggccaagaugcuccucgacaacaucaacacccccgagggcaucauccccgcccucuucgagcccgagcgcgagaaguccgccgccaucgacggcgagucccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaccaaccagguccucgaggagaacauggccgucgagaucuggcccaaggagggcgagcgcaagaagcuccgcccccgcugccucgacgcccgcaccuacuccgacccccucgcccuccgcgaguucaaggaguucccccccggccgccgcuccgucuccggcgaccucauccucgagaucggcaagcucccccacccccucacccagcgcccccagaacgcccucgccacccucgucaugucccacaccuccgagcagggcggccgcgccuaccgccacgccauggaggagcuccccgccaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacuccaacgccacccgccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgccaagggcuggcccaucuccaagauggacaucggcgucccccuccucgcccucggcugcuacucccaggucaacccccucacccucaccgcccccguccucaugcucgucccccacuaccccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucaccaaguccgaguucaacaccuacaagcgcuccggcaucauggaggucgaccgcuccgaggccaaggagggccucaagcgcggcgagaccaccaagcaccccgucucccgcggcaccgccaagcuccgcugguucgucgagcgcacccucgucaagcccgagggcaaggucaucgaccucggcugcggccgcggcggcugguccuacuacugcgccggccucaagaaggucaccgaggucaagggcuacaccaagggcggccccggccacgaggaccccauccccaugggcaccuacggcuggaaccucgucaagcuccgcuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacauggccuccgucgucgagacccucgagcagaugcagcgcaagcacggcggcaugcucguccgcaacccccucucccgcaacuccacccacgagauguacugggucuccuggggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgagggcaagcccuccggcuccgccuccuccauggucaacggcggcgucaagcuccucaccaagcccugggacggcauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccggcggcaucuucuccccccgcgagcucgagacccccaaccucgccgagcgcguccucgacugggucgagaaguacggcgucgagcgccucgagcgcauggccaucuccggcgacgacugccucggcgagcccaucuacgaccgcuucgccaccgcccucaccgcccucaacgacaugggcaagguccgcaaggacaucccccagugggagcccuccaagggcuggaacgacuggcagcagggccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauggacuuccaccgccgcgaccuccgccucgccgccaacgccaucugguccgccggccccggcgacuggauccccacccgccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacauggccuccaugaagcgcuucaagaacgaguccgaccccgagggcgcccucugguga

SEQ ID NO: 11270 - RNA, 9879 nt, Artificial Sequence
  derived and/or modified CDS sequence (opt2) from DENV-1__KF921942__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucgccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11271 - RNA, 9879 nt, Artificial Sequence
  derived and/or modified CDS sequence (opt2) from DENV-1__JF937602__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucguccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11272 - RNA, 9879 nt, Artificial Sequence
  derived and/or modified CDS sequence (opt2) from DENV-1__GU131729__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccucggcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggccccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgcccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcacccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgagggcaagcccuccggcuccgccuccuccaugggcaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11273 - RNA, 9879 nt, Artificial Sequence
  derived and/or modified CDS sequence (opt2) from DENV-1__GU131730__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccgcgccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaccauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacaucuacaugggccagccccucaacaacgacgaggaccacgcccccuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11274 - RNA, 9879 nt, Artificial Sequence
  derived and/or modified CDS sequence (opt2) from DENV-1__GU131731__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcacccacaacaaggagggcgaccaguacaucuccaugggccagccccucaacaccgccgaggaccacgcccccuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggaccccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11275 - RNA, 9879 nt, Artificial Sequence
  derived and/or modified CDS sequence (opt2) from DENV-1__GU131733__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaacaucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11276 - RNA, 9879 nt, Artificial Sequence
  derived and/or modified CDS sequence (opt2) from DENV-1__GU131734__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccgacuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaucgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11277 - RNA, 9879 nt, Artificial Sequence
  derived and/or modified CDS sequence (opt2) from DENV-1__GU131738__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccggccgcuccuggaacuccggcuacgaguggaucaccgacuuccccggcaagaccgucugguucggccccaccaucaaguccggcaacgacaucgccaacugccuccgcaagaacggcaagcgcgucauccagcucucccgcaagaccuucgacaccgaguaccagaagaccaagaacaacgacugggacuacgucggcaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucggccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11278 - RNA, 9879 nt, Artificial Sequence
  derived and/or modified CDS sequence (opt2) from DENV-1__JF937604__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaccuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuucuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacgccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcagggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucucccagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11279 - RNA, 9879 nt, Artificial Sequence
  derived and/or modified CDS sequence (opt2) from DENV-1__JF937605__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccacccuccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccaacgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11280 - RNA, 9879 nt, Artificial Sequence
  derived and/or modified CDS sequence (opt2) from DENV-1__JF937608__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11281 - RNA, 9879 nt, Artificial Sequence
  derived and/or modified CDS sequence (opt2) from DENV-1__GU131739__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccccaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11282 - RNA, 9879 nt, Artificial Sequence
  derived and/or modified CDS sequence (opt2) from DENV-1__GU131740__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacguccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaaggucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11283 - RNA, 9879 nt, Artificial Sequence
  derived and/or modified CDS sequence (opt2) from DENV-1__GU131741__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgucuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11284 - RNA, 9879 nt, Artificial Sequence
  derived and/or modified CDS sequence (opt2) from DENV-1__GU131743__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacgucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11285 - RNA, 9879 nt, Artificial Sequence
  derived and/or modified CDS sequence (opt2) from DENV-1__JN093516__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccacccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11286 - RNA, 9879 nt, Artificial Sequence
  derived and/or modified CDS sequence (opt2) from DENV-1__GU131746__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11287 - RNA, 9879 nt, Artificial Sequence
  derived and/or modified CDS sequence (opt2) from DENV-1__JF937609__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11288 - RNA, 9879 nt, Artificial Sequence
  derived and/or modified CDS sequence (opt2) from DENV-1__KF921949__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguuccgcaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucaccaagaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11289 - RNA, 9879 nt, Artificial Sequence
  derived and/or modified CDS sequence (opt2) from DENV-1__GU131747__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccgucuuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccguccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11290 - RNA, 9879 nt, Artificial Sequence
  derived and/or modified CDS sequence (opt2) from DENV-1__GU131748__SS-prME
uccgucaccaugcucuucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucaagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11291 - RNA, 9879 nt, Artificial Sequence
  derived and/or modified CDS sequence (opt2) from DENV-1__GQ868615__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11292 - RNA, 9879 nt, Artificial Sequence
  derived and/or modified CDS sequence (opt2) from DENV-1__GU131749__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuaccgcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11293 - RNA, 9879 nt, Artificial Sequence
  derived and/or modified CDS sequence (opt2) from DENV-1__GU131750__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucuccaucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucaugcagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaccauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11294 - RNA, 9879 nt, Artificial Sequence
  derived and/or modified CDS sequence (opt2) from DENV-1__GU131751__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaaggucauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccauccgcgacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcuccaaguggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacauccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccaccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11295 - RNA, 9879 nt, Artificial Sequence
  derived and/or modified CDS sequence (opt2) from DENV-1__GU131753__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucaucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaugaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaccgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcgucuucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11296 - RNA, 9879 nt, Artificial Sequence
  derived and/or modified CDS sequence (opt2) from DENV-1__GU131754__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggacaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugcauguccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11297 - RNA, 9879 nt, Artificial Sequence
  derived and/or modified CDS sequence (opt2) from DENV-1__GU131755__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11298 - RNA, 9879 nt, Artificial Sequence
  derived and/or modified CDS sequence (opt2) from DENV-1__GU131756__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgccuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11299 - RNA, 9879 nt, Artificial Sequence
  derived and/or modified CDS sequence (opt2) from DENV-1__GU131758__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacguccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaaggucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11300 - RNA, 9879 nt, Artificial Sequence
  derived and/or modified CDS sequence (opt2) from DENV-1__GU131759__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccuucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaaggucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11301 - RNA, 9879 nt, Artificial Sequence
  derived and/or modified CDS sequence (opt2) from DENV-1__GU131761__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagauccaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11302 - RNA, 9879 nt, Artificial Sequence
  derived and/or modified CDS sequence (opt2) from DENV-1__GU131762__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaugucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuuccucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcgucuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11303 - RNA, 9879 nt, Artificial Sequence
  derived and/or modified CDS sequence (opt2) from DENV-1__GU131763__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggccucggcgaggucgacuccuucucccucggccuccucugcaucuccaucaugaucgaggaggucaugcgcucccgcuggucccgcaagaugcucauggccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagcgcugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaacaaggucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11304 - RNA, 9879 nt, Artificial Sequence
  derived and/or modified CDS sequence (opt2) from DENV-1__GU131766__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaucgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaucgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugcgccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11305 - RNA, 9879 nt, Artificial Sequence
  derived and/or modified CDS sequence (opt2) from DENV-1__GU131767__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccgcgccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11306 - RNA, 9879 nt, Artificial Sequence
  derived and/or modified CDS sequence (opt2) from DENV-1__HM181967__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacauggccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11307 - RNA, 9879 nt, Artificial Sequence
  derived and/or modified CDS sequence (opt2) from DENV-1__GU131768__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaacuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgccgacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11308 - RNA, 9879 nt, Artificial Sequence
  derived and/or modified CDS sequence (opt2) from DENV-1__GU131770__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11309 - RNA, 9879 nt, Artificial Sequence
  derived and/or modified CDS sequence (opt2) from DENV-1__GU131773__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcaugaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuuccuccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11310 - RNA, 9879 nt, Artificial Sequence
  derived and/or modified CDS sequence (opt2) from DENV-1__GU131775__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucgucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcggcaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11311 - RNA, 9879 nt, Artificial Sequence
  derived and/or modified CDS sequence (opt2) from DENV-1__GU131777__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11312 - RNA, 9879 nt, Artificial Sequence
  derived and/or modified CDS sequence (opt2) from DENV-1__GU131778__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacauccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucucccgcauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11313 - RNA, 9879 nt, Artificial Sequence
  derived and/or modified CDS sequence (opt2) from DENV-1__GU131779__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgucuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga
